United States Patent 10,407,724 (METHODS AND COMPOSITIONS FOR SCREENING AND TREATING DEVELOPMENTAL DISORDERS) - sequence listing, part 3

SEQ ID NO: 33 - DNA, 583403 bp, Homo sapiens
aaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattata

SEQ ID NO: 34 - DNA, 627094 bp, Homo sapiens
cctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaat

SEQ ID NO: 35 - DNA, 630046 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacag

SEQ ID NO: 36 - DNA, 639624 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattata

SEQ ID NO: 37 - DNA, 2962 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacata

SEQ ID NO: 38 - DNA, 7272 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgta

SEQ ID NO: 39 - DNA, 3040 bp, Homo sapiens
tgctttaaattcgataattcaggaacacacttaaaacataaagcaagcatttctgtcctctatatgtttcttaaatgatctctagaaaaatcatgtaagtccaaactaagttattattactttttggaacagaatgtatagcgtgtagactgaaactagattataggatatgatttctttagtttacactcaaactttgtgctccttttaaaaacatttttatcttcttcaaatgaaaacacagacatctttgccaagtccctatttttaaaagttggggtaaaatatgcataacataaaattgactgttttaatcattttaacgtgtattattcagtagcaataagtacattaacattgttatgcaaccatcttcattatctatctccaaaacgttgtcattccaaacagaaactctgcactcattaaaaaaaggatagttctcacctcattcccacctcctctggcctctggtaacctctattctactttttgtctgtatgaatttgtctattcttggtacctcatataagtggaatcacacactatttgtccttttgtgtctggcttatttcacttagcataatattttcaaggttcatccatgttgtaacatataacagaatttcattcctttcgaagcccgaataacattctattgtatgtatataccacattttgtttatctattcatctgtttatcaacatttcggttgtttatccattttggctattgtaataatgcttcccataaacattgatatacatatatttatttgaatccctgttttcaatttttttgggtatatacctagatgtaggagaagtgctggatgatatggtaattctacattcagctttatatatatatatataaagctatatatgcatatacatagttatatacgtgtacatagatacacacacacacaactttttaaaaagttatttacttttttaagtaaccaccaaactattcagtgcaacggttgtaccattttgtatccccaccagctatgcataaggctttcaattttccacatctttgagaacacttgttattttccttttatttttaaaatagccatcctaatgggtgtaaagttctggggtgttttccaaaactaacaaccagttctccaattcttcagacaccaatttggatgtccaacaattcaagtcaattctgacactgcctgaaattgcatcacattccacagataaatgggttcagtacccacttcagatgccaattgcaagtcccaggccatcggtaattctgaccaaccaactacaaatggtaggttcccatgacgcccctcctcatgttcaacagtttgctagaatggcttacagaactcagggaaacactttacttatgtttactagtttattataacttaggaacagcccgctggaagagatgcacagggcagagcatggggagtgtagtgcagaacttccatgccctactgggcgttatcaccttcccagcaagttaatgtgttcaccaaacagaaaactctctaaatctcactgttcaagagtttttacagagctccatctccagggcctgccctcccctcttcccaggggtcagtaggtgggactgaaagtctcaaccctctaattacttggtctttctggggaccagctccatcctgaggctctttaggggccccactctaaaaaaccttatgaacataaactcaggtgtgattgaaaagggttcattataaataacaaaagacactcctttcacttagaaaattccaagagtcttaggagccctgtgccaggaaccagagataaagaccaatatatttttgcattataccacaaaattggtacctcctggtggttttgatttgcatttacccaacgactattgatttggggcattttctctttttttttttttttttgagacagggtctcactctgtcacccaggctagaatgcagtggtgtgatcatggctcaccataacttcaacttcttgggctcaagcgatgctcctgcttcagcctcctaaatagccaggactacacatgtgtgccaccatgcctggctaatttttagaaaatttttgtagagatcgtgtctcactacgtttcccaggctagtcttgaactcctggactcaagcaatcctcccacgtcagcctcccaaagtgttgggattacaggcatgaaccactgtgcccagccagcatctttttattcattggccatttctatatctttggagaaatgtttattcaagtcctttgcccattctttaaaccgggttgccagttcttctattgttgagtcactggagttctttatatattctggatattaatcccttatcagatatatgatttgcaaatattttatcatattccttgggctgcttcttcattttcttgatgtgttctttgatgcacagagaatttttaatattgagagagtccaatttgtctatttttttctcttgttgactgtgctttcgttgtcattccaagaaatcattgccaaatccagtgtcatgaaggattttctgtgttcttctaagagttttatagttttagctcttttgtttagatatttgctcccattttgagttactttttgtatgtaatataaggtaagggttcaccatcattcttttgcatgtggatatccagttttcccagaaccatttgttgaaaagactgtcctttctccattgaatggcattggcgcacttgttgaaagtcatttgatgatatatgtaagagtttatttttgtcatggaaataggtcctataatccttttgcaggtatataaaagatacttcttaacaatataaatatacataacacagaaaggctatgccagaggggctatcataaataataaaagcatattgtaacaaaagaagaaaaacaaataccacccaaaattatttaaagcacatttttattatagataggttaagtgtggtttgctgtggctaaagatatatttataatggatgaacaagcttttctagataccaagaggtataatatttt

SEQ ID NO: 40 - DNA, 9294 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtg

SEQ ID NO: 41 - DNA, 17684 bp, Homo sapiens
cacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 42 - DNA, 20127 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 43 - DNA, 20584 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggcccc

SEQ ID NO: 44 - DNA, 21841 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 45 - DNA, 21904 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggc

SEQ ID NO: 46 - DNA, 23618 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggc

SEQ ID NO: 47 - DNA, 27162 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 48 - DNA, 28797 bp, Homo sapiens
cttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 49 - DNA, 30558 bp, Homo sapiens
ggatttcaaagactgataagacttccaaaaaattctgaggactaacagaatttgtgcacatatatttaatatattggccaaaagccagtttcggtggctcaagcctgtaatcccagcactttgggaggccggtggatcacctaagatcaggggttcaagaccagcctggccaacatggtgaaaccctgtctctactaaaaaaaatacaaaaaaattagccaggcgtggtggcgggcgcctgtaatcccagctacttgggaagctgaggcaggagaattgcttgaacctgggaggcagaggttgcagtgagccaagatggcacctctgcactccagcctgggtgacagcgcaagacttggtctcaaaaaaaaaaaaaaagtatatatatatatatatatatatatatgcgccaaaaaagaacatgaacaatgaaacaaaactactactgtatcgtggctattattgcttttttaaaatatatttttaaatattttattttattttttacctccaaataccatcaccattttatttaattattattacttttttgagacagtctatctctgtcacccagattggagtgcagtggcatggctcactgcagcctcaacctcccaggctcgagatcctctcacctcagcctcccatgtatttgggaccataggcagatgccaccatgcccagctaattcttttattttttgtagagacagaggtctcactttgttgccaggttggtcttgaacccctgatcgccattatttcataaaagcacattttaacaccaaagaagtagaaaagacataatttcagaataaataattactttttaaattaaatacatttccctgcctgggcaatatgttgagacgctacctctactaaaaatgcaagaattagctgggcgtggtggcgcgcgcctgtattctcagctacttggaggggggctgaggcaggagacttgcttgaacccaggaggcgaaggctgcagtgagcccagatcgcgctactgcactacagcctgggtgacacctcaaaaacaaatttttttttaataataataaattgaatatatttacctttaacaaaaacactactacattatccttattgttttcattttgctgcagaccagtgagaacattgtcatggaaaccaccacttgcaccaccagaaagatgcagaagaaaagaagtgagacgttagagactgtcagaggaggggaaggtgaagaggcaggaaatagggggtaagaagtccaccagcaaggtgctcccctgtcctgaactgacccccttctgctcactgaagtctgaggtggccagttttgggccctgggcagagctgtggccatgctcacaggtcaggcagctcagggattcccggcgctggagaccctggtgatcttgttcctactcccccgcaatgcagaggtaccctggacatgtgcctgtgaccggtgctggcaggccatggtacaggacttggagtcaggagcagagctaggcctggctctgctactcaccagctgagttactgggagaagtccctgccttctctgggcctcggtttcctcaactgaaaataaaggttctgaactagttgtttttgaggaaaccggaagatctctggcttaagaaaaaaaaaagccatgcccataatattttgtacagaattccaggggcttcaccacccctcagggccttcagtgggttccccaggggctgctaaccctgacacgcagttgctggccccttgccttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 50 - DNA, 31885 bp, Homo sapiens
gccagcctggtgactgacccaatactgtttcttttgctttttattgttaaaattacatactttggcttgaattctttcacttgcagctacaggagttgtgattccctcatggctccttgaggtaagcaaggggccctcactgccaaggcgactaggcacaaatgtggctcagcctcaccgagtgggagaaggaaggggctctagagccagcgagtctacacatgcaccctacgcacaggtggtgtgggcagggtggcagcacggggcattcccctgctatgtcccctctggagacctctctgtgcatgaaccttttgcctgaacacagaggttgtagggagccctccttggcccgtctgaggaaggcccctgtcataggctaagctgcttggaaaagctcagtcccctcccatgggtgaaggcaatggggcagcacacctggccgccagacaccactgcccactctgtccttcaggccaaagccctagggtcaaagggccagcccagtccaggaggaggcggcaggtcagctccctcttctccctccgggcctgtctttctcccaagctgagctgatagcctctcagcagggccagcctgtcccgggaagaagtaaaatgagaagtgtgtgttctgagccctgcccctggttcagagtatgttgtgtgggtggggtgactagaagctgggaaagagctgatctcccttgggcatgctgggcctctccttctagagaccctcctgtcctcacagacagagcagggcaaccccaccctcaccctgcacccctggctcaatggctcaggtccccctgctctgactctagcattgccaccaccaacccagctttccactgaggagccacctcaacaggggctattcccacagaccctcaagttcctttgcacgctgaccgccccatctccaatctgtatccccaacaagcagacaccatctccttgctgttctacccacagctactcactgtcacttccaaacctttgcccaccctgtacccctggttggaaacccttagtctctctgcttgccaaatcccagtcccccttcaaggcttagcaaaacagcgcggccctctcctgccagggtccgggacatacaaccttgaggcctccacctcctcacctccaaacacttcccactctggtcctcttctctaggaaggctttgctgatctatctttgcatatcaaactcttagggcacccactcgttcctcactctccccagattacttttagagttccttcaggaaggacttgagtaatgcgcaattttcatgaggtcagttttccccagaattttattttggatttcaaagactgataagacttccaaaaaattctgaggactaacagaatttgtgcacatatatttaatatattggccaaaagccagtttcggtggctcaagcctgtaatcccagcactttgggaggccggtggatcacctaagatcaggggttcaagaccagcctggccaacatggtgaaaccctgtctctactaaaaaaaatacaaaaaaattagccaggcgtggtggcgggcgcctgtaatcccagctacttgggaagctgaggcaggagaattgcttgaacctgggaggcagaggttgcagtgagccaagatggcacctctgcactccagcctgggtgacagcgcaagacttggtctcaaaaaaaaaaaaaaagtatatatatatatatatatatatatatgcgccaaaaaagaacatgaacaatgaaacaaaactactactgtatcgtggctattattgcttttttaaaatatatttttaaatattttattttattttttacctccaaataccatcaccattttatttaattattattacttttttgagacagtctatctctgtcacccagattggagtgcagtggcatggctcactgcagcctcaacctcccaggctcgagatcctctcacctcagcctcccatgtatttgggaccataggcagatgccaccatgcccagctaattcttttattttttgtagagacagaggtctcactttgttgccaggttggtcttgaacccctgatcgccattatttcataaaagcacattttaacaccaaagaagtagaaaagacataatttcagaataaataattactttttaaattaaatacatttccctgcctgggcaatatgttgagacgctacctctactaaaaatgcaagaattagctgggcgtggtggcgcgcgcctgtattctcagctacttggaggggggctgaggcaggagacttgcttgaacccaggaggcgaaggctgcagtgagcccagatcgcgctactgcactacagcctgggtgacacctcaaaaacaaatttttttttaataataataaattgaatatatttacctttaacaaaaacactactacattatccttattgttttcattttgctgcagaccagtgagaacattgtcatggaaaccaccacttgcaccaccagaaagatgcagaagaaaagaagtgagacgttagagactgtcagaggaggggaaggtgaagaggcaggaaatagggggtaagaagtccaccagcaaggtgctcccctgtcctgaactgacccccttctgctcactgaagtctgaggtggccagttttgggccctgggcagagctgtggccatgctcacaggtcaggcagctcagggattcccggcgctggagaccctggtgatcttgttcctactcccccgcaatgcagaggtaccctggacatgtgcctgtgaccggtgctggcaggccatggtacaggacttggagtcaggagcagagctaggcctggctctgctactcaccagctgagttactgggagaagtccctgccttctctgggcctcggtttcctcaactgaaaataaaggttctgaactagttgtttttgaggaaaccggaagatctctggcttaagaaaaaaaaaagccatgcccataatattttgtacagaattccaggggcttcaccacccctcagggccttcagtgggttccccaggggctgctaaccctgacacgcagttgctggccccttgccttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 51 - DNA, 1781 bp, Homo sapiens
tttttgcaatttggcattatggaactcaactttaaatgcctaacctctaactcagccattctatttctaagaattaattctgcgcagtcccccgttttgggaacatttcccacgcctgttctccattctcctgtagaaggggaacagggagcgggaaggaggggaacagggaaggggagggaggggaacagggaggggggacaggagggaggagaacaggcagtgggggcgggaggggagcgggggggaaggcatgggagggggcggaagggagggggcagggagggagagaggtgatgggaaggggaaaaggagggaggaggacggagagaggggaaaggagggaggggagcagagaagaagcggggcggggaaggggcggggaaggggcgtggaagggagtggggcaaggaatcaacactgagccccgtggcccgctcccgggtcagcgcgcctctctgctctcaccggggcgggtccgctgttggccccacccactcccagcccacccggccccgcaatggcccggcccagccgcccacccccccgacaggccccgccccattccccgccccccgtctgttcgtcacgcccggctctgccgctccgtcccgcaggccccgccctcatcccgcctcccggcccggcgcgcagtgcggctgcgcgggcgtctcaggctctgaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctcccc

SEQ ID NO: 52 - DNA, 3323 bp, Homo sapiens
tttttgcaatttggcattatggaactcaactttaaatgcctaacctctaactcagccattctatttctaagaattaattctgcgcagtcccccgttttgggaacatttcccacgcctgttctccattctcctgtagaaggggaacagggagcgggaaggaggggaacagggaaggggagggaggggaacagggaggggggacaggagggaggagaacaggcagtgggggcgggaggggagcgggggggaaggcatgggagggggcggaagggagggggcagggagggagagaggtgatgggaaggggaaaaggagggaggaggacggagagaggggaaaggagggaggggagcagagaagaagcggggcggggaaggggcggggaaggggcgtggaagggagtggggcaaggaatcaacactgagccccgtggcccgctcccgggtcagcgcgcctctctgctctcaccggggcgggtccgctgttggccccacccactcccagcccacccggccccgcaatggcccggcccagccgcccacccccccgacaggccccgccccattccccgccccccgtctgttcgtcacgcccggctctgccgctccgtcccgcaggccccgccctcatcccgcctcccggcccggcgcgcagtgcggctgcgcgggcgtctcaggctctgaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctccccacactgataacaaacttgggtttctgtcctaggaactgaaacatgaaaacatcgtggccctgtacgacttccaggtaaggcctctgggctgcggtctgctggggaccgggctgggggactgtggccccaggtgctggatcccctggtgagcactggtgttgagcctgtccaggctggggtctactgggcccctggagactccaccctgggtccaggcctgggctggtgctggctcttgctgtgacttccccagctgtgagaccggggagggggtgtctgggccgcagggcgccccagggcagggctgagttctcctgaacaggcatcccctccccgccgggcgtcagtcctaggggccctgcctgagtccggcgtccccggctggccctggcagcactgccggcctggcccacctgtctaggccgtgtgtttgttgacattgctcctgcggccggcattggccggcctcgctctgcgtcagacggggcgggggaggggccgccggagactcctgctcgctggcagtcagggccgggccggggcacaggcggctgccgctggctggccaaggagatgacctcgggcccggctggccccaagaagcaagcggtgggaccagctggctttcgtgctgcctccgtgtcccggggcccagggcaggcagggctggggctgtgggagccagggtgccgtcctggggaccaggaacctgaggcgggagatccgccccgccaaagtgctgactaatggctctgtgacctgtttactgagcccagggcccagcccctggctgagggaagggctggcaggccgtgttttggtggcctcctccgtccgcctctcagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctggccaggcagcgactctgagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttt

SEQ ID NO: 53 - DNA, 420 bp, Homo sapiens
cagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaagg

SEQ ID NO: 54 - DNA, 1025 bp, Homo sapiens
cagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggccct

SEQ ID NO: 55 - DNA, 7825 bp, Homo sapiens
aatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggac

SEQ ID NO: 56 - DNA, 8856 bp, Homo sapiens
cagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagt

SEQ ID NO: 57 - DNA, 12209 bp, Homo sapiens
aatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagt

SEQ ID NO: 58 - DNA, 28846 bp, Homo sapiens
aaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaaggga

SEQ ID NO: 59 - DNA, 29518 bp, Homo sapiens
aaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtc

SEQ ID NO: 60 - DNA, 124461 bp, Homo sapiens
ggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct

SEQ ID NO: 61 - DNA, 130858 bp, Homo sapiens
aatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcct
